United States Patent 11,976,277 (PARTICLE DELIVERY SYSTEMS) - sequence listing, part 4

SEQ ID NO: 34939 - protein, 91 aa, Carlito syrichta
VAVGDIPFYFSREEWGTLDPAQRDLFWDIKRENSRNTTLGLGLKSQSERSRLEEVVTGLPGPVGSPVTAAWSPEEAEAWESENRPRAALGR

SEQ ID NO: 34940 - protein, 87 aa, Balaenoptera acutorostrata
VVFEDVAVNFTLEEWALLDFSQKKLYRDVMGETFRNLASVGETWKDHDIEDQRKNQGRKLRSHKVGRICVGREDSPCRENLSLIPNL

SEQ ID NO: 34941 - protein, 82 aa, Vicugna pacos
VTFGDIPFYFSREEWGSLDPAQRDLFWDIKRENSRNLALGLGLKDQSERSRLHEVVTTLPGQVVGDGTPPTRRRQFRDLASE

SEQ ID NO: 34942 - protein, 91 aa, Colobus angolensis
VALGDIPFYFSREEWGTLDPAQRDLFWDIKRENSRNTTVGLGLKGQNEKSRLEEVVPVLPGHTGSDVTVSWSPEEAEAWESENRPRAALGP

SEQ ID NO: 34943 - protein, 97 aa, Mustela putorius
EKIEDMAVSLIREEWLLDPSQKDPSRDNRPENYRNMFSLGGETRNENRELSSKQVISTGLQPHGETAAKCNGDVIGGLEHGEARDLLGRLERQRGNP

SEQ ID NO: 34944 - protein, 82 aa, Myotis brandtii
VTFEDIALYFSSEEWSLLDEGQRQLYLNVMVENFELISSLAFIVNKVVTLEKSLISAVNVENLLHGSMPFVIIIEFIQEKSL

SEQ ID NO: 34945 - protein, 91 aa, Myotis brandtii
VAFEDVAVNFTLEEWALLDPSQKKLYRDVMRETLKNLASIGRKLEDHNIGDQYKNQGRNLRHMVERDCESKGSQYGENFNLISNLNLNKKT

SEQ ID NO: 34946 - protein, 89 aa, Odobenus rosmarus
VMFEEVSVCFTSEEWECLGPIQRALYWDVMLENYGNVTSLEWETMTENEEVTPKPSISQRADSQKGTSKRLQGVVPQTLDFEEACEWQV

SEQ ID NO: 34947 - protein, 97 aa, Erinaceus europaeus
EKIEDMAVSLIQEEWLLNSSQKDLSRDNRPENLRSVFSLGGETRNENKEIASKQVTSTGIQPHGEAAVRCNGDVIRGLEQGESKDLLGRLERQRGNP

SEQ ID NO: 34948 - protein, 84 aa, Colobus angolensis
LTFEDVAVYFSEEEWQLLDPPEKTLYNDVMQDIYETVISLGLKLKNDTGNNHPISVSTSEIQTSGCKVSKKTRMKIAQKTMGRE

SEQ ID NO: 34949 - protein, 92 aa, Colobus angolensis
VMFEEVSVCFTSEEWACLGPIQRALYWDVMLENYGNVTSLGKDSSFCDGNKFHSWGLGKAIKEVAFILELEEKYRILFGEINIQNWVISHRN

SEQ ID NO: 34950 - protein, 97 aa, Carlito syrichta
EKIEDMAVSLIREEWLLDPSQKDLSRDSRPENYRNMFSLGGETRNENRELTSKQVISSGIQPHGETAARCNGDVIGGLEHGEAQDLLGRLERQRGNP

SEQ ID NO: 34951 - protein, 93 aa, Vicugna pacos
LASAPFHPPRIQEEWGLLDPSQKELYWDAMLEKYGTVVSLGLPRPRAEVEREALSAGTEGHKSLHLGGDSEAPSFRGPRPWPLVIHRKGHAGQ

SEQ ID NO: 34952 - protein, 88 aa, Ornithorhynchus anatinus
VTFEDVAVTFTRAEWEHLDSAQCSLHWQVMLENYRNLTSLREYSLLGASRCRRGFHVTCLNCPGEDSWMEDGKTCDTEGRLGKPRRNP

SEQ ID NO: 34953 - protein, 97 aa, Vicugna pacos
EKIEDMAVSLIREEWLLDPSQKDLSRDNRPENYRNLFSLGGETRNENRELVSKQVISSGIQPHGETAAKCNGDVIGVLERGEARDLLGTLERQRGNP

SEQ ID NO: 34954 - protein, 98 aa, Muntiacus reevesi
VTFGDIPFYFSREEWGSLDPAQRDLFWDIKRENSRNVALGLGRRSHSERSQLEEVVTALPDQAAGDETTSWRPEEAEAWEGGARPGAPRGRGSGARRG

SEQ ID NO: 34955 - protein, 89 aa, Balaenoptera acutorostrata
VMFEEVSVCFTSEEWACLGPIQRALYWDVMLENYGNVTSLEWETMTENEEVTSKSSLSQRADSQKGTSKRLQGSVPQVLDFEEEYEWQV

SEQ ID NO: 34956 - protein, 92 aa, Myotis brandtii
VSFEDVAVNFSLEEWALLDPSQKKLYREVMLETFRNLVSIVLQLRCKYVREPTQERSPINVNTVGKPSDVIKVFRDMKEITLKRNPIYAKNA

SEQ ID NO: 34957 - protein, 92 aa, Vombatus ursinus
MEFKDVAVDFTLEEWEQLHFAQRELYKDVMLENYRNLVFLGKTLPSYSTPKITQNLLFKPSLLPHLLNAIRCLKCLAEFWFVIQGMISANPF

SEQ ID NO: 34958 - protein, 86 aa, Myotis brandtii
VTFRDVAIDFSQEEWECLDPAQQKLYLDVMSENYSNLVSVAVPLKDNQAFRPKPGIENLFPEIIQRIHTGEKPYKCRECGKRASSM

SEQ ID NO: 34959 - protein, 87 aa, Pteropus alecto
VAFEDVVVTFTLEEWVLLNPSQKKLYRDVMRETIRSLASVGKKWEKHDTKDQHKNHGRTLRSHMIDKIYATKESSQCGENFSVISNL

SEQ ID NO: 34960 - protein, 85 aa, Balaenoptera physalus
REFQGAGRGGLGREEGRLGGGSSVSGRGRRLQYERGGPGPEQAAEAAGNEQITGCLIPKPDVISQLEQGEEPWITEVEFSNQSLP

SEQ ID NO: 34961 - protein, 86 aa, Myotis brandtii
LTFRDVAIDFSQEEWECLDPAQRKLYLDVMLENYSNLASVAMSSEDDQAFFLKPGIQDLFSEIILQSKYNEDASYQWNEHWKNFKQ

SEQ ID NO: 34962 - protein, 89 aa, Saimiri boliviensis
MTFEDVAMSLTWEEWERLDPARKDFYRESVQKDSGSTVLPSLESRTENKELIPMQEILEEAEPPEQLQEAFQGKPPLFSKCGHTHDNRV

SEQ ID NO: 34963 - protein, 93 aa, Panthera pardus
LTFEEVAMYFSQEEWELLDPTQKALYNDVMRENYETVISLAVPVHQILAFSEKTNTKDWTVAPELVLPESQSLLTFEEVAMYFSQEEWEFLDP

SEQ ID NO: 34964 - protein, 97 aa, Balaenoptera acutorostrata
EKIEDMAVSLIREEWLLDSSQKDLSRDNRPENYRNMFSLGGETRNENRELASKQVISTGIQPHGETAAKCNGDVIGGLEHGEAQDLLGTIERQRGNP

SEQ ID NO: 34965 - protein, 86 aa, Myotis brandtii
VTFEDIALYFSREEWSLLDEGQRQLYLNVMLEIFELISSLARAVTFVIIREFIQEKSLTNAVNVENLLHGGMSFVIIREFIQEKSL

SEQ ID NO: 34966 - protein, 103 aa, Sapajus apella
LTFEDVAVYFSEEEWQLLDPPEKTLYNDVMQDIYETVISLGLKLKSDTGNDHPVSVSASEMQTPGCKVSKNSRMKIAQKTMGRENHGDTPRVQKWHRAFPRKK

SEQ ID NO: 34967 - protein, 82 aa, Puma concolor
LTFEEVAMYFSQEEWELLDPTQKALYNDVMRENYETVISLENHQPICVSDLEIQAPGDIVSKKARAKVPQKTTGKENHGDTH

SEQ ID NO: 34968 - protein, 87 aa, Myotis brandtii
VAIEDVVVTFTLEEWALLDSSQKKLYRDVMRQTFKNLASIGKKWDDHDIEELYKNQGRKLRNHMAERLCETKEGSQCEDNSNLISEM

SEQ ID NO: 34969 - protein, 89 aa, Camelus ferus
VTFGDVAVFFSRDEWLHLNPTQRALYREVMLDNFSALASLGRKGNAVVGGVKEGVTPSATGGRWLRVADFLRIPPFFIISVVSVDQTVI

SEQ ID NO: 34970 - protein, 82 aa, Panthera pardus
VTFEDVAVLFTPEEWMFLDSAQRSLYRDVMLENYRNVASVEPSLPPQGSIPNQDIFAEISVDMERGRPQTGENLYERSELGK

SEQ ID NO: 34971 - protein, 88 aa, Camelus ferus
RSLENDGVCFSEQEWENLEDWQKELYTNVMKSNYETLVSLMGHSSAHLTFQCVAQMKLDALKGDHVRRCLASQKETRSWVQRCWVTWR

SEQ ID NO: 34972 - protein, 91 aa, Rhinolophus ferrumequinum
VTFGDIPFYFSREEWGSLDPAQRDLFWDIKRENSRNIALGLGMKSQSEGSQLEEAVMALPGQVGGDVTVAWSPEEAETWESEDRLGATVGR

SEQ ID NO: 34973 - protein, 107 aa, Pteropus alecto
LTFRDVAIEFSLEEWEFLDCAQRALYRDVMSENYRNLLSMDISTRCVIKELSPKEDISNGELFQILILERDISHDFNDFDFREVQQNMHKVEDQWVCEEKNYEGDPT

SEQ ID NO: 34974 - protein, 107 aa, Oryctolagus cuniculus
VTFKDVVVEFSKEEWEQLDSAGKNLYRDVMLENYRNLNSLHEVFYFFLDMESVSENQLSVPKQRVSGEESFPGIIVTKLFRSRHPSLALQKDEDWLHRNQNKQYVNL

SEQ ID NO: 34975 - protein, 83 aa, Pantherophis guttatus
DAFEEVTVDFTKEEWRLLELDQKILCWEVMQEFSRNLAALADVSVNENGGEKSSTSLPVVVRGFLSQQDQKEKRKGKYRKKDN

SEQ ID NO: 34976 - protein, 86 aa, Pantherophis guttatus
MSLKEVAVNFTEEEWALLDSTQKALHWEVMLENSRNVNTLAGDEKEIENCQEPDMATSPAIHLELRKEIFGVQWRSQTHRESHSQP

SEQ ID NO: 34977 - protein, 102 aa, Micrurus lemniscatus
ASFEDVAVYFSKEEWCQLDADQKALHGEVMLENSRNLSSLGYYNGQKNTNCKEECQAIHSKEGKGKRYQCIECGNTFTHSSSLHSHKRIHTGEKSYQCMECG

SEQ ID NO: 34978 - protein, 83 aa, Pantherophis guttatus
ISFKELSICFTEEEWGLLDSDQKALHGEVMLEMSRNVASLAGNERKNEIYQESEEAPIQILKVEVGEENQWQPKNEDGIRLND

SEQ ID NO: 34979 - protein, 84 aa, Octadecabacter ascidiaceicola
AIAEELASRFPEANMWPTDPAARALARTVAAEMHSSFGGLRGNWPVNLRHVFTGAVAPPEIEKELDRLETIWANAREKSDSTTP

SEQ ID NO: 34980 - protein, 82 aa, Pelodiscus sinensis
VSFEEVAVYFSEEEWALLDPGQRALYRDVMQENYEAVSWLGTGWVSLQKFSFIASGAHLPLRAMEVSIQLLPAGYGGEGSFP

SEQ ID NO: 34981 - protein, 98 aa, Pseudonaja textilis
MSFEEVAVYFSEVEWSHLEPDQKALHFEVMMENHENVASLGKNLPLECLGRQFVNKYSRELQVIDAGDRMEKPSIQMELENHEQNQSNNWKQENLSSI

SEQ ID NO: 34982 - protein, 84 aa, Pseudonaja textilis
LSFDDVAIFFSVEEWDLLDFNQKILYNEVMLENARNVASTESAYYKQTSVKQSQTVRNDIGEGMFENPQGPETPERNQLNKRRA

SEQ ID NO: 34983 - protein, 100 aa, Pseudonaja textilis
VSFEEVAVYFSDEEWSHLDADQKVLHGEVMLENSKNVASLGKDLLLHILVPTTHYFWISSILSQCPSYGSHLMGEKYPCGEAKKYSDWTVSTRGSIHVEE

SEQ ID NO: 34984 - protein, 84 aa, Geotrypetes seraphini
ITFKDVAAYFLETEWDILGDRKKEIYKQIIKDIHDLFISRGSHIYTAEPTVEILKMEEDPVSSQLEGGEEDTDTKSDDRFGNKR

SEQ ID NO: 34985 - protein, 95 aa, Micrurus spixii
VSFEDVAVYFFEEEWTEMDPDQKALHREVMLENYRNVASLGDDEQDHKEPRQSFQGFRHGDVMEKRAIQTKFQRQKRNPSNIWNKENSSSIEAHV

SEQ ID NO: 34986 - protein, 91 aa, Pantherophis guttatus
VSFEEVAVHFHEEEWSQLDPHQRALHWGVMLENYKNVVSLGENENDNKDSGEPIKVFRQGDVMEKPAIQTEFQRQEGNLSTNWNKKSSPSI

SEQ ID NO: 34987 - protein, 85 aa, Pogona vitticeps
MTFEEVAVYFTQEEWALLDPDQRALHQEVMEENFGVVTSLDNWMKTKACTKCGKCFLHKLDLARHQRTHMGEESSTREEPKKCKK

SEQ ID NO: 34988 - protein, 97 aa, Rattus norvegicus
EKIEDMAVSLIREEWLLDPSQKDLNRDNRPEKYRNMFSLDGETRNENKELFSKQVISPRIQPHGEATAKCNGDIIVGLEHGETQDLLGKLERHQGNH

SEQ ID NO: 34989 - protein, 97 aa, Mus musculus
ERIEDMAVSLIREEWLLDPSQKDLNRDNRPEKYRNMFSLDGETRSENKELFPKQGISPGIQPHGEATAKCNGDVIVGLAHGETQDLLGKLERHQGNP

SEQ ID NO: 34990 - protein, 85 aa, Thermococcus chitonophagus
DSAQDLLEYSSSLEWNKLIKGTFAVRRERMINCSHNVEGLDKKLGAIIHAQGFKVSLSRPDTVVRIYCGERLWLGVRIREFRGKE

SEQ ID NO: 34991 - protein, 91 aa, Mus musculus
VTFQDVAVDFNEEEWRLLGPTQKTEYHDVMLETLGNLVSVGWEPTLGNRELTPDSPIPVVKPIHDPNTNDLSRNGTQSTVFESILEDGVKE

SEQ ID NO: 34992 - protein, 83 aa, Paroedura picta
FSFEEVAVSFSEAEWGLLDPGQRALYREVMLENYRTVAFLAGDDQRNEEEGELPGLSPDEVKNEDFRNQRRPKRQNGSRTVEK

SEQ ID NO: 34993 - protein, 89 aa, Paroedura picta
VFFEEVAVHFTEAEWALLDPAQRALYREVMLENYGSVALLAGDHLENEEGNELHHLSPDKVKNEDLRGKIQNQGGPKMEKKSHVVQNDE

SEQ ID NO: 34994 - protein, 85 aa, Paroedura picta
FSLEEVSVSFSEAEWALLDPGQRALCREVMLENSENVAFLASGEHCQRFRQFCYLEADGPREVCSQLHGLCNRWLEPERSTKKQI

SEQ ID NO: 34995 - protein, 84 aa, Paroedura picta
VSFEEVAVSFTEAEWALLGPSQRALFREVMVENYGSVSSLGARNRRETLVVKDNCQASEERLESFSRGSEEDVSFPNEPAETEA

SEQ ID NO: 34996 - protein, 91 aa, Paroedura picta
VTLEDVSVLLTQEEWALLDADQRALYIEVMLENCGNVATLAGNRWKTEAEGKLCPISLDAATFAKEKLQRRKTEAEQKREEGRRADPGSDE

SEQ ID NO: 34997 - protein, 90 aa, Pantherophis guttatus
VSLEEVVVCFSEDEWSRLNPVQKALYRDVMLENSRNVAFLEQWWRTYGTHAGGGHASLRQDAFRPKADFPFTKWEGKNGLLDCCFRLPGP

SEQ ID NO: 34998 - protein, 83 aa, Mus musculus
VTFQDVAVDFSQEEWQLLGPMQRTKYHDVMLETLGNLVSVALGQVHVEDGGAGPNRNGSQPLVRRSSFIPLPAGTRPSAILWS

SEQ ID NO: 34999 - protein, 83 aa, Cricetulus griseus
TSAWDVSVDLSQEEWECLDCAQRALYMDVMLENYGHLLFVENHRICGNGEKAMHQGTRHFIHDHENIQEKYYTFNESAKEIHE

SEQ ID NO: 35000 - protein, 90 aa, Ailuropoda melanoleuca
VTFEDVFVYFSQEEWELLEEAQRLLYRDVMLENLALVASLASQCPHFLVFHTHVCDGLRLFTKVNVYLTILFLLSGRWRVTDDEETPSEQ

SEQ ID NO: 35001 - protein, 101 aa, Otolemur garnettii
VTFQDVAVDFTREEWGLLGPTQRTEYHDVMLETFGHLVSVGTLSWGFTTFGLRTRTGYAIKAPLIHPGSLFYLFIYLFIYIIASGVCGWRLSSLSHRCQAH

SEQ ID NO: 35002 - protein, 84 aa, Camelus dromedarius
VTFADVAVDFTQEEWTLLDPFQRNLSRDVMLENTPILALVHQRQMPSQGFTEKQTHNKIMVKNINIGKDSLEETMPHVIQVLQV

SEQ ID NO: 35003 - protein, 87 aa, Myotis davidii
VTFEDVNVEFTMEEWAFLDPAQKKLYTDVMLETFWNLASVACILEEKCEDHDSEDQYEHHEMNLSSHMVESLCKWKDGSQFRETFRQ

SEQ ID NO: 35004 - protein, 85 aa, Neomonachus schauinslandi
VTFEEVAVDFSQEEWALLDPAQKILYRDVMLENYRNLASVGYPFCKHSLIMEVEQEVLGTEEGAVLQGAYTDWDIQLKSKDGIPM

SEQ ID NO: 35005 - protein, 85 aa, Physeter macrocephalus
LTFEEVAMYFSKEEWELLDPTQKALYSDVMQENYETVISLGLFLSLYFAYPPTNEVCYEPDTRYESIHLTIWCCKLLKYPLLFLK

SEQ ID NO: 35006 - protein, 103 aa, Pteropus alecto
VAVNFSVEEWALLDPSQKKLYRDVMRETFRNLASVGKKWEAHDIEDQYKNQGRKQRHTVNAPYQCKVCGKTFSTSTSLQICESTHTGEKPYQCKYCGKALRNY

SEQ ID NO: 35007 - protein, 86 aa, Myotis brandtii
LTFRDVAIDFSQEEWECLDETQQKLYMDVMLENYSNLASLATSSKDNQAFMLKPGVHDLFSEIILSTHNGDSSYQWNEHWNNFKQE

SEQ ID NO: 35008 - protein, 84 aa, Carlito syrichta
LSFEDVAVYFTREEWQFLDPIQKVLYKEVMLENYGNLVSVGFVILNRHFAEKDYDDFSGYGKSCLYIKHDRTLIGLKYHRCINP

SEQ ID NO: 35009 - protein, 86 aa, Myotis brandtii
VAFEDINVEFTMEEWAFLDPTQKKLYTDVMLETFWNLASVEFMKECILGKNPMNVTIVVKLSLIQLPSNVMKELIIRKNPMNDSVA

SEQ ID NO: 35010 - protein, 88 aa, Alligator mississippiensis
EVFEDVAVYFTREEWELLEEEDKVLYWDQMLKNYQALVSLGKCCFHALKFNHVEISSCSLLLQEMTDVTGQSAGAWLLSRAEEQIPVV

SEQ ID NO: 35011 - protein, 100 aa, Paroedura picta
ALSSEVAVSFTEAEWALLGPGQRALHREVMLENYGSVAFLGADQEDAEDEELHRCRWLEPEKHTKQQMLDLVILEQFLALLPQEMQGWVRGCGPESSSQA

SEQ ID NO: 35012 - protein, 83 aa, Paroedura picta
FSLEEVSVSFTEAEWALLDPGQRALHWEVMREISQDLAFLGEDEEGNEEDKEIQRQTPDLKEKGSYQGRPKIRMLEEQDGRKC

SEQ ID NO: 35013 - protein, 86 aa, Paroedura picta
FSFEEVAVSFSEAEWTLLDPGQRALFREVMLENYGGVASLARHSRETTMGTNKRRVAAEWPESFPRRYQGAISFPTELVATGDAEE

SEQ ID NO: 35014 - protein, 97 aa, Alligator mississippiensis
VTFKEVAVYFTEGQWALLGPSQRALYRDVMLENFKMVGSLGDQPCGPQNSYKRDLSFHTLSCGRGELATLWNCVISQLEQGEDPWVPDHQVLERMKI

SEQ ID NO: 35015 - protein, 104 aa, Paroedura picta
FSLEEVSVSFTEAEWALLDPGQRALYMEVMLENSGHVAFLARSIRDSLVETGLVAERRLASSPRGSQEHISFPSELAETEDDPRNEEGEELHQQDRVKNEDLKE

SEQ ID NO: 35016 - protein, 97 aa, Heterocephalus glaber
EKLEDMAVSLIREEWFLDPSKKDLSRDNRPENCRNTFSLGGETRNENKELTSKQVISAGIQPHGETAARCNGDVIRGLEHGEAQDLLGKLERQRGNP

SEQ ID NO: 35017 - protein, 83 aa, Camelus ferus
CGFADVAVYFSLEEWGCLQPAQRALYRDVMRETYGHLGALGEAPPARLRPHPRPTLPSLWVLHVEWEAPGWSILSTCCTLPSP

SEQ ID NO: 35018 - protein, 89 aa, Paroedura picta
VTLEEVSVHFPEEEWALLDPGQRRLHQEVMEENSQNVASLEADGPQDKSQEEPQHHLLEIQDEKRINATKWKGGNEWPPQGPESQPASL

SEQ ID NO: 35019 - protein, 84 aa, Paroedura picta
FSFEEVSFSFTEAEWALLDPGQRTLYREVMLENYGSIKSLEARSIRETLVETGNGLASEERLESFSRGSQEQISFPNELAETED

SEQ ID NO: 35020 - protein, 110 aa, Lithobates catesbeianus
IRCQDVTVYFSMEEWQYLEGHKDLYKDVMMENQPPLTSPDGSSNGNPPERCPHPLYSWDSTQEDHPIPHHHQSDEQIKMKAEVKEEEVETYVGGDQPSTEEVEMIMKSEQ

SEQ ID NO: 35021 - protein, 86 aa, Paroedura picta
FSLEEVSVSFTEAEWALLDPGQRALHWEVMLEIFGDVVFLVKEARSPGETLVEMDKRLAGQEILAISPGGSRGQVSSPAELAETED

SEQ ID NO: 35022 - protein, 98 aa, Alligator mississippiensis
NLIRHQIIHTGEKPYKCSDCGKSFIGNSQLIQHQRIHTGEKPYECCDCGKSFSRSLVARSWPCFSPGFPITKPDMISRMEQKEEPWVLRVQGYEEKEI

SEQ ID NO: 35023 - protein, 97 aa, Fukomys damarensis
EKIEDMAVSLIQEEWLLDPSKKDLSRENRPENCKNMFSLGGETRNENKELTSKQVISAGIQPHEETAARCNGDVIRGLEHGEPQDLLGRLERQRGNP

SEQ ID NO: 35024 - protein, 100 aa, Chelonia mydas
VTFDDVSVYFSEQEWENLDEWQKELYKNVMKGNYETLISLATRGSWFEVRSRSVYRVAGECRYLFPRTDYAISKPDILSQIDRGEEPCVRDREDSERREI

SEQ ID NO: 35025 - protein, 106 aa, Camelus ferus
VTFDDITVYLLQEEWMLLSQQRKELCGSDKLEAPLEEVERLGTSRLDLDVSGYRGVPGGKPHLWTAELQGAFVSGPTIANPELFYKFERGPEPWLARVQGQRTLLS

SEQ ID NO: 35026 - protein, 86 aa, Pteropus alecto
ISFKDMTANFTLDDWLRLTGTQRPLYQAVMRENCAPLVSVESTSELIISDGSYARKKPDECTECGETYHGEKSYELSQNGEGYSQS

SEQ ID NO: 35027 - protein, 90 aa, Vulpes vulpes
VVFEDVAVDFTVEEWALLDSAQRKLYREVMLENLKNLASVDDETQFKASGSVSQQDVHGNKIPKEHKITKSTRNDSWASVLGKIWEELST

SEQ ID NO: 35028 - protein, 89 aa, Myotis davidii
VTFEDVAVYFTQNQWASLDPVQRALYRDVMLENYANVAALGRGLNVSLDLSFFLTEVAFPAPKPDLISQLERGSAPWGPDPWEAEVLRG

SEQ ID NO: 35029 - protein, 85 aa, Myotis davidii
VTFQDVAVVFTEEELALLDPSQRKLYRDVMLENFRNLVSVAFLKLLGTALPARTLHISARTYICRSKKTRMTTLKEEVTFQDVAV

SEQ ID NO: 35030 - protein, 92 aa, Myotis davidii
LTFHDVAVDFTWDEWQLLDPAQKDLYMDVMLETYSHLVSVVAGELPCGTRSDIWKLDDHLPEHVQNESMENSLEQCHKNKLFENCDYEIKEP

SEQ ID NO: 35031 - protein, 91 aa, Myotis davidii
LTFEDVAVHFSEEEWKLLAPTQKTLYNEVMQENYETVISLGLKLKNDTGNDPPMSTSTLEIQTSGCKVLRKARMKVAQKTTDKENHGGTHK

SEQ ID NO: 35032 - protein, 90 aa, Tupaia chinensis
LTFEEVAMYFSQEEWELLDPTQKALYNDVMQENYETVISLGQQEQAMGCPVLGLEETSEETLSNSSFLYLEKQGPSAHDLRDSVTTGPGK

SEQ ID NO: 35033 - protein, 83 aa, Chelonia mydas
MENDKIQAGSDQKQSNKKESHSITTYNGRQLKGDKFLKCLYTNARSLNNKMGLPLPKPDLIFRLQQGKEPWVPDLQAPERRQI

SEQ ID NO: 35034 - protein, 99 aa, Chelonia mydas
VTFEEVAVYFSEGEWALLDLGQRALYRDVMQENYENVTSLGDEMLCKNEEENPQAGRTCASEIVWEGIGRIRRKCSCTERNWWESEWIKEAKGKGLREG

SEQ ID NO: 35035 - protein, 8 aa, unidentified
  REGION 1..8: note = protease cleavage site
SQNYPIVQ

SEQ ID NO: 35036 - protein, 8 aa, unidentified
  REGION 1..8: note = protease cleavage site
ARVLAEAM

SEQ ID NO: 35037 - protein, 8 aa, unidentified
  REGION 1..8: note = protease cleavage site
ATIMIQKG

SEQ ID NO: 35038 - protein, 8 aa, unidentified
  REGION 1..8: note = protease cleavage site
RQANFLGK

SEQ ID NO: 35039 - protein, 8 aa, unidentified
  REGION 1..8: note = protease cleavage site
SFSFPQIT

SEQ ID NO: 35040 - DNA, 2937 bp, synthetic construct
  misc_feature 1..2937: note = CasX variant
  source 1..2937: mol_type = other DNA
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccggcgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 35041 - DNA, 2934 bp, synthetic construct
  misc_feature 1..2934: note = CasX variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 35042 - DNA, 2937 bp, synthetic construct
  misc_feature 1..2937: note = CasX variant
  source 1..2937: mol_type = other DNA
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 35043 - DNA, 2937 bp, synthetic construct
  misc_feature 1..2937: note = CasX variant
  source 1..2937: mol_type = other DNA
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccggcgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 35044 - protein, 979 aa, synthetic construct; identical to SEQ ID NO: 176
  REGION 1..979: note = CasX variant

SEQ ID NO: 35045 - protein, 978 aa, synthetic construct; identical to SEQ ID NO: 350
  REGION 1..978: note = CasX variant

SEQ ID NO: 35046 - protein, 979 aa, synthetic construct; identical to SEQ ID NO: 354
  REGION 1..979: note = CasX variant

SEQ ID NO: 35047 - protein, 979 aa, synthetic construct; identical to SEQ ID NO: 355
  REGION 1..979: note = CasX variant

SEQ ID NO: 35048 - RNA, 99 nt, synthetic construct; identical to SEQ ID NO: 2292
  misc_feature 1..99: note = gRNA
  source 1..99: mol_type = other RNA

SEQ ID NO: 35049 - protein, 8 aa, unidentified
  REGION 1..8: note = cleavage site
TSCYHCGT

SEQ ID NO: 35050 - protein, 8 aa, unidentified
  REGION 1..8: note = cleavage site
ARQMTAHT

SEQ ID NO: 35051 - DNA, 128 bp, synthetic construct
  misc_feature 1..128: note = sgRNA
  source 1..128: mol_type = other DNA
actggcgcttttatctgattactttgagagccatcaccagcgactatgtcgtagtgggtaaagctccccgtacaccattagggtacggggagcatcaaagcgagacgtaattacgtctcgtttttttt

SEQ ID NO: 35052 - DNA, 19 bp, synthetic construct
  misc_feature 1..19: note = hairpin
  source 1..19: mol_type = other DNA
cgtacaccattagggtacg

SEQ ID NO: 35053 - DNA, 163 bp, synthetic construct
  misc_feature 1..163: note = guide scaffold
  source 1..163: mol_type = other DNA
actggcgcttttatctgattactttgagagccatcaccagcgactatgtcgtagtgggtaaagctgcactatgggcgcagcaaggagtttatatggaaacccttgctgacggtacaggccaaggagtttatatggaaacccttggtatagtgcagcatcaaag

SEQ ID NO: 35054 - DNA, 147 bp, synthetic construct
  misc_feature 1..147: note = guide scaffold
  source 1..147: mol_type = other DNA
actggcgcttttatctgattactttgagagccatcaccagcgactatgtcgtagtgggtaaagctgcactatgggcgcagcgccctgaagaagggcgctgacggtacaggccgccctgaagaagggcggtatagtgcagcatcaaag

SEQ ID NO: 35055 - DNA, 173 bp, synthetic construct
  misc_feature 1..173: note = guide scaffold
  source 1..173: mol_type = other DNA
actggcgcttttatctgattactttgagagccatcaccagcgactatgtcgtagtgggtaaagctgcactatgggcgcagcggctcgtgtagctcattagctccgagccgctgacggtacaggccggctcgtgtagctcattagctccgagccggtatagtgcagcatcaaag

SEQ ID NO: 35056 - DNA, 177 bp, synthetic construct
  misc_feature 1..177: note = guide scaffold
  source 1..177: mol_type = other DNA
actggcgcttttatctgattactttgagagccatcaccagcgactatgtcgtagtgggtaaagctgcactatgggcgcagcccgtgtgcatccgcagtgtcggatccacgggctgacggtacaggccccgtgtgcatccgcagtgtcggatccacggggtatagtgcagcatcaaag

SEQ ID NO: 35057 - DNA, 161 bp, synthetic construct
  misc_feature 1..161: note = guide scaffold
  source 1..161: mol_type = other DNA
actggcgcttttatctgattactttgagagccatcaccagcgactatgtcgtagtgggtaaagctgcactatgggcgcagcatccattgcactccggatagctgctgacggtacaggccatccattgcactccggatagctggtatagtgcagcatcaaag

SEQ ID NO: 35058 - DNA, 157 bp, synthetic construct
  misc_feature 1..157: note = guide scaffold
  source 1..157: mol_type = other DNA
actggcgcttttatctgattactttgagagccatcaccagcgactatgtcgtagtgggtaaagctgcactatgggcgcagcatgcatgtctaagacagcatgctgacggtacaggccatgcatgtctaagacagcatggtatagtgcagcatcaaag

SEQ ID NO: 35059 - DNA, 162 bp, synthetic construct
  misc_feature 1..162: note = guide scaffold
  source 1..162: mol_type = other DNA
actggcgcttttatctgattactttgagagccatcaccagcgactatgtcgtagtgggtaaagctgcactatgggcgcagcaaaacataaggaaaacctatgttctgacggtacaggccaaaacataaggaaaacctatgttggtatagtgcagcatcaaag

SEQ ID NO: 35060 - DNA, 175 bp, synthetic construct
  misc_feature 1..175: note = guide scaffold
  source 1..175: mol_type = other DNA
actggcgcttctatctgattactctgagcgccatcaccagcgactatgtcgtagtgggtaaagccgcttacggactatgggcgcagcaaggagtttatatggaaacccttgctgacggtacaggccaaggagtttatatggaaacccttggtatagtccgtaagaggcatcagag

SEQ ID NO: 35061 - DNA, 159 bp, synthetic construct
  misc_feature 1..159: note = guide scaffold
  source 1..159: mol_type = other DNA
actggcgcttctatctgattactctgagcgccatcaccagcgactatgtcgtagtgggtaaagccgcttacggactatgggcgcagcgccctgaagaagggcgctgacggtacaggccgccctgaagaagggcggtatagtccgtaagaggcatcagag

SEQ ID NO: 35062 - DNA, 185 bp, synthetic construct
  misc_feature 1..185: note = guide scaffold
  source 1..185: mol_type = other DNA
actggcgcttctatctgattactctgagcgccatcaccagcgactatgtcgtagtgggtaaagccgcttacggactatgggcgcagcggctcgtgtagctcattagctccgagccgctgacggtacaggccggctcgtgtagctcattagctccgagccggtatagtccgtaagaggcatcagag

SEQ ID NO: 35063 - DNA, 189 bp, synthetic construct
  misc_feature 1..189: note = guide scaffold
  source 1..189: mol_type = other DNA
actggcgcttctatctgattactctgagcgccatcaccagcgactatgtcgtagtgggtaaagccgcttacggactatgggcgcagcccgtgtgcatccgcagtgtcggatccacgggctgacggtacaggccccgtgtgcatccgcagtgtcggatccacggggtatagtccgtaagaggcatcagag

SEQ ID NO: 35064 - DNA, 173 bp, synthetic construct
  misc_feature 1..173: note = guide scaffold
  source 1..173: mol_type = other DNA
actggcgcttctatctgattactctgagcgccatcaccagcgactatgtcgtagtgggtaaagccgcttacggactatgggcgcagcatccattgcactccggatagctgctgacggtacaggccatccattgcactccggatagctggtatagtccgtaagaggcatcagag

SEQ ID NO: 35065 - DNA, 169 bp, synthetic construct
  misc_feature 1..169: note = guide scaffold
  source 1..169: mol_type = other DNA
actggcgcttctatctgattactctgagcgccatcaccagcgactatgtcgtagtgggtaaagccgcttacggactatgggcgcagcatgcatgtctaagacagcatgctgacggtacaggccatgcatgtctaagacagcatggtatagtccgtaagaggcatcagag

SEQ ID NO: 35066 - DNA, 175 bp, synthetic construct
  misc_feature 1..175: note = guide scaffold
  source 1..175: mol_type = other DNA
actggcgcttctatctgattactctgagcgccatcaccagcgactatgtcgtagtgggtaaagccgcttacggactatgggcgcagcaaaacataaggaaaacctatgttgctgacggtacaggccaaaacataaggaaaacctatgttggtatagtccgtaagaggcatcagag

SEQ ID NO: 35067 - protein, 1662 aa, synthetic construct
  REGION 1..1662: note = dCas-KRAB fusion
ATMGARASVLSGGELDRWEKIRLRPGGKKKYKLKHIVWASRELERFAVNPGLLETSEGCRQILGQLQPSLQTGSEELRSLYNTVATLYCVHQRIEIKDTKEALDKIEEEQNKSKKKAQQAAADTGHSNQVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNPATIMIQKGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGSDPSSQNFSQNYPIVQAAAAPAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTLEGGSPKKKRKV

SEQ ID NO: 35068 - protein, 1634 aa, synthetic construct
  REGION 1..1634: note = dCas-KRAB fusion
ATMGARASVLSGGELDRWEKIRLRPGGKKKYKLKHIVWASRELERFAVNPGLLETSEGCRQILGQLQPSLQTGSEELRSLYNTVATLYCVHQRIEIKDTKEALDKIEEEQNKSKKKAQQAAADTGHSNQVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNPATIMIQKGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGSDPSSQNFSQNYPIVQAAAAPAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTLEGGSPKKKRKV

SEQ ID NO: 35069 - protein, 1149 aa, synthetic construct
  REGION 1..1149: note = dCas-KRAB fusion
ATMPAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTLEGGSPKKKRKV

SEQ ID NO: 35070 - protein, 1121 aa, synthetic construct
  REGION 1..1121: note = dCas-KRAB fusion
ATMPAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTLEGGSPKKKRKV

SEQ ID NO: 35071 - protein, 16 aa, unidentified
  REGION 1..16: note = nuclear export signal
NSNELALKLAGLDINK

SEQ ID NO: 35072 - protein, 17 aa, unidentified
  REGION 1..17: note = nuclear export signal
RTFDMHSLESSLIDIMR

SEQ ID NO: 35073 - protein, 17 aa, unidentified
  REGION 1..17: note = nuclear export signal
TNLEALQKKLEELELDE

SEQ ID NO: 35074 - protein, 17 aa, unidentified
  REGION 1..17: note = nuclear export signal
RGVDCLSSHFQELSIYQ

SEQ ID NO: 35075 - protein, 17 aa, unidentified
  REGION 1..17: note = nuclear export signal
RSFEMTEFNQALEEIKG

SEQ ID NO: 35076 - protein, 15 aa, unidentified
  REGION 1..15: note = nuclear export signal
LKEVDQLRLERLQID

SEQ ID NO: 35077 - protein, 16 aa, unidentified
  REGION 1..16: note = nuclear export signal
NLNELALKLAGLDINK

SEQ ID NO: 35078 - protein, 18 aa, unidentified
  REGION 1..18: note = nuclear export signal
SSLQELVQQFEALPGDLV

SEQ ID NO: 35079 - protein, 16 aa, unidentified
  REGION 1..16: note = nuclear export signal
ERVVSPGIDLSGLTLQ

SEQ ID NO: 35080 - protein, 14 aa, unidentified
  REGION 1..14: note = nuclear export signal
EAETVSAMALLSVG

SEQ ID NO: 35081 - protein, 20 aa, unidentified
  REGION 1..20: note = nuclear export signal
MEELSQALASSFSVSQDLNS

SEQ ID NO: 35082 - protein, 13 aa, unidentified
  REGION 1..13: note = nuclear export signal
LQLPPLERLTLDC

SEQ ID NO: 35083 - protein, 17 aa, unidentified
  REGION 1..17: note = nuclear export signal
STVDEMTKKFGTLTIHD

SEQ ID NO: 35084 - protein, 19 aa, unidentified
  REGION 1..19: note = nuclear export signal
HVDIRTLEDLLMGTLGIVC

SEQ ID NO: 35085 - protein, 17 aa, unidentified
  REGION 1..17: note = nuclear export signal
RELDELMASLSDFKFMA

SEQ ID NO: 35086 - protein, 14 aa, unidentified
  REGION 1..14: note = nuclear export signal
EMFRELNEALELKD

SEQ ID NO: 35087 - protein, 78 aa, unidentified
  REGION 1..78: note = nuclear export signal
RERENMDTDDERQYQDFLEDLEEDEAIRKNVNIYRDSAIPVESDTDDEGAPRISLAEMLEDLHISQDATGEEGASMLT

SEQ ID NO: 35088 - protein, 14 aa, unidentified
  REGION 1..14: note = nuclear export signal
ALSAQLYSSLSLDS

SEQ ID NO: 35089 - protein, 55 aa, unidentified
  REGION 1..55: note = nuclear export signal
MFQAAERPQEWAMEGPRDGLKKERLLDDRHDSGLDSMKDEEYEQMVKELQEIRLE

SEQ ID NO: 35090 - protein, 14 aa, unidentified
  REGION 1..14: note = nuclear export signal
FLNAFEDSFSSILS

SEQ ID NO: 35091 - protein, 16 aa, unidentified
  REGION 1..16: note = nuclear export signal
IDASLTKLFECMTLAY

SEQ ID NO: 35092 - protein, 10 aa, unidentified
  REGION 1..10: note = nuclear export signal
MIDGIGRFYI

SEQ ID NO: 35093 - protein, 13 aa, unidentified
  REGION 1..13: note = nuclear export signal
DLWQSLAQVSLRK

SEQ ID NO: 35094 - protein, 16 aa, unidentified
  REGION 1..16: note = nuclear export signal
EVDNLPEDMKRLHLDD

SEQ ID NO: 35095 - protein, 15 aa, unidentified
  REGION 1..15: note = nuclear export signal
QEDILDELLGNMVLA

SEQ ID NO: 35096 - protein, 11 aa, unidentified
  REGION 1..11: note = nuclear export signal
LVSLIRLKSKL

SEQ ID NO: 35097 - protein, 15 aa, unidentified
  REGION 1..15: note = nuclear export signal
YKRIEELLYKISLTT

SEQ ID NO: 35098 - protein, 34 aa, unidentified
  REGION 1..34: note = nuclear export signal
CTLSDSGRISYTVEFSLPTHHTVRLIRVTASPSA

SEQ ID NO: 35099 - protein, 12 aa, unidentified
  REGION 1..12: note = nuclear export signal
LEELCAARRLSL

SEQ ID NO: 35100 - protein, 20 aa, unidentified
  REGION 1..20: note = nuclear export signal
VSQIFPDSVMLAVQEGIDLL

SEQ ID NO: 35101 - protein, 23 aa, unidentified
  REGION 1..23: note = nuclear export signal
PNCPFLENSLETLRFSISNLSMQ

SEQ ID NO: 35102 - protein, 18 aa, unidentified
  REGION 1..18: note = nuclear export signal
LDSSLANLVGNLGIGNGT

SEQ ID NO: 35103 - protein, 11 aa, unidentified
  REGION 1..11: note = nuclear export signal
ELITFINALKL

SEQ ID NO: 35104 - protein, 12 aa, unidentified
  REGION 1..12: note = nuclear export signal
LRLTLLELVRRL

SEQ ID NO: 35105 - protein, 33 aa, unidentified
  REGION 1..33: note = nuclear export signal
MVNFVSVGLFRCLPVPCPEDLLVEELVDGLLSL

SEQ ID NO: 35106 - protein, 12 aa, unidentified
  REGION 1..12: note = nuclear export signal
LFGDTIAYLLSL

SEQ ID NO: 35107 - protein, 10 aa, unidentified
  REGION 1..10: note = nuclear export signal
ISPRLDAIKL

SEQ ID NO: 35108 - protein, 9 aa, unidentified
  REGION 1..9: note = nuclear export signal
DLVLLSLVL

SEQ ID NO: 35109 - protein, 10 aa, unidentified
  REGION 1..10: note = nuclear export signal
PVSKITFVTL

SEQ ID NO: 35110 - protein, 40 aa, unidentified
  REGION 1..40: note = nuclear export signal
LAPNVAALLFGGNVAVRELADSYEITYNYKMTVPKSDPNV

SEQ ID NO: 35111 - protein, 10 aa, unidentified
  REGION 1..10: note = nuclear export signal
ILMRMSKMQL

SEQ ID NO: 35112 - protein, 27 aa, unidentified
  REGION 1..27: note = nuclear export signal
DEMTKKFGTLTIHDTEKYASQPELCNN

SEQ ID NO: 35113 - protein, 71 aa, unidentified
  REGION 1..71: note = nuclear export signal
QRVTSTQQQTRISASSATRELDELMASLSDFKFMAQGKTGSSSPPGGPPKPGSQLDSMLGSLQSDLNKLGV

SEQ ID NO: 35114 - protein, 10 aa, unidentified
  REGION 1..10: note = nuclear export signal
IIELLKGLDL

SEQ ID NO: 35115 - protein, 10 aa, unidentified
  REGION 1..10: note = nuclear export signal
CILCQLLLLY

SEQ ID NO: 35116 - protein, 39 aa, unidentified
  REGION 1..39: note = nuclear export signal
TDPFLAMQVQELTRSMANLTFKQRRDAPPEGPSAKKPKK

SEQ ID NO: 35117 - protein, 14 aa, unidentified
  REGION 1..14: note = nuclear export signal
ELDTNFFTLYVAQG

SEQ ID NO: 35118 - protein, 10 aa, unidentified
  REGION 1..10: note = nuclear export signal
LERLFGRLRI

SEQ ID NO: 35119 - protein, 6 aa, unidentified
  REGION 1..6: note = nuclear export signal
EQCERA

SEQ ID NO: 35120 - protein, 6 aa, unidentified
  REGION 1..6: note = nuclear export signal
LEKLKL

SEQ ID NO: 35121 - protein, 511 aa, unidentified; identical to SEQ ID NO: 573
  REGION 1..511: note = glycoprotein

SEQ ID NO: 35122 - protein, 511 aa, unidentified; identical to SEQ ID NO: 654
  REGION 1..511: note = glycoprotein

SEQ ID NO: 35123 - protein, 505 aa, unidentified; identical to SEQ ID NO: 655
  REGION 1..505: note = glycoprotein

SEQ ID NO: 35124 - protein, 523 aa, unidentified; identical to SEQ ID NO: 656
  REGION 1..523: note = glycoprotein

SEQ ID NO: 35125 - protein, 530 aa, unidentified; identical to SEQ ID NO: 657
  REGION 1..530: note = glycoprotein

SEQ ID NO: 35126 - protein, 512 aa, unidentified; identical to SEQ ID NO: 658
  REGION 1..512: note = glycoprotein

SEQ ID NO: 35127 - protein, 511 aa, unidentified; identical to SEQ ID NO: 659
  REGION 1..511: note = glycoprotein

SEQ ID NO: 35128 - protein, 523 aa, unidentified; identical to SEQ ID NO: 660
  REGION 1..523: note = glycoprotein

SEQ ID NO: 35129 - protein, 524 aa, unidentified; identical to SEQ ID NO: 661
  REGION 1..524: note = glycoprotein

SEQ ID NO: 35130 - protein, 521 aa, unidentified; identical to SEQ ID NO: 662
  REGION 1..521: note = glycoprotein

SEQ ID NO: 35131 - protein, 512 aa, unidentified; identical to SEQ ID NO: 663
  REGION 1..512: note = glycoprotein

SEQ ID NO: 35132 - protein, 513 aa, unidentified; identical to SEQ ID NO: 664
  REGION 1..513: note = glycoprotein

SEQ ID NO: 35133 - protein, 517 aa, unidentified; identical to SEQ ID NO: 665
  REGION 1..517: note = glycoprotein

SEQ ID NO: 35134 - protein, 525 aa, unidentified; identical to SEQ ID NO: 666
  REGION 1..525: note = glycoprotein

SEQ ID NO: 35135 - protein, 529 aa, unidentified; identical to SEQ ID NO: 667
  REGION 1..529: note = glycoprotein

SEQ ID NO: 35136 - protein, 556 aa, unidentified; identical to SEQ ID NO: 668
  REGION 1..556: note = glycoprotein

SEQ ID NO: 35137 - protein, 559 aa, unidentified; identical to SEQ ID NO: 669
  REGION 1..559: note = glycoprotein

SEQ ID NO: 35138 - protein, 511 aa, unidentified; identical to SEQ ID NO: 670
  REGION 1..511: note = glycoprotein

SEQ ID NO: 35139 - protein, 511 aa, unidentified; identical to SEQ ID NO: 671
  REGION 1..511: note = glycoprotein

SEQ ID NO: 35140 - protein, 982 aa, unidentified; identical to SEQ ID NO: 634
  REGION 1..982: note = glycoprotein

SEQ ID NO: 35141 - protein, 981 aa, unidentified; identical to SEQ ID NO: 635
  REGION 1..981: note = glycoprotein

SEQ ID NO: 35142 - protein, 978 aa, unidentified; identical to SEQ ID NO: 636
  REGION 1..978: note = glycoprotein

SEQ ID NO: 35143 - protein, 987 aa, unidentified; identical to SEQ ID NO: 637
  REGION 1..987: note = glycoprotein

SEQ ID NO: 35144 - protein, 982 aa, unidentified; identical to SEQ ID NO: 638
  REGION 1..982: note = glycoprotein

SEQ ID NO: 35145 - protein, 981 aa, unidentified; identical to SEQ ID NO: 639
  REGION 1..981: note = glycoprotein

SEQ ID NO: 35146 - protein, 563 aa, unidentified; identical to SEQ ID NO: 582
  REGION 1..563: note = glycoprotein

SEQ ID NO: 35147 - protein, 684 aa, unidentified
  REGION 1..684: note = glycoprotein
MVLLPGSMLLTSSLHHLRHQMSPGSWKRLIILLSCVFGGGGTSLQNKNPHQPMTLTWQVLSQTGDVVWDTKAVQPPWTWWPTLKPDICALAAGLESWDIPGTDVSSSKRVRPPDSDYTAAYKQITWGAIGCSYPRARTRMASSTFYVCPRDGRTPSEARRCGGLESLYCKEWNCETTGTGYWLPKSSKDLITGRWDQNSKWDQKFQKCHQTGWCNPLKIDFTDTGKSSRDWIVGKTWGLRFYVHGHPGVQFTIRLKITSMTAVAVGPDPVLVEQGPPRRALALPPPLPPREAPPPPLPDSNSTTLATSAQTPTVGKTIVTLNTPPPTTGDRLFNLVQGAFLTLNATNPGATKSCWLCLAMGPPYYEAITSLGEVAYSTSQDRCHWGTQGKLTLTEVSGHGLCIGKVPFTHQHLCNQTLSINSSEGHQYLLPSNHSWWACSTGLTPCLSTSVFNQSRDFCIQVQLIPRIYYYPEEVLLQAYDDSHPRPKREAVSLTLAVLLGLGITAGIGTGSTALIKGPIDLQQGLTSLQIAIDADLRALQDSVSKLEDSLTSLSEVVLQNRRGLDLLFLKEGGLCAALKEECCFYIDHSGAVRDSMKKLKEKLDKRQLERQKNQNWYEGWFNNSPWFTTLLSTIAGPLLLLLLLLILGPCIINKLVQFINDRVSAVKILVLRTKYQALDNEDN

SEQ ID NO: 35148 - protein, 565 aa, unidentified; identical to SEQ ID NO: 579
  REGION 1..565: note = glycoprotein

SEQ ID NO: 35149 - protein, 488 aa, unidentified; identical to SEQ ID NO: 578
  REGION 1..488: note = glycoprotein

SEQ ID NO: 35150 - protein, 524 aa, unidentified; identical to SEQ ID NO: 593
  REGION 1..524: note = glycoprotein

SEQ ID NO: 35151 - protein, 522 aa, unidentified; identical to SEQ ID NO: 594
  REGION 1..522: note = glycoprotein

SEQ ID NO: 35152 - protein, 598 aa, unidentified
  REGION 1..598: note = glycoprotein
MGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLETRTTNQFLAVSKGNCSGPTTIRGQFSNMSLSLLDLYLSRGYNVSSIVTMTSQGMYGGTYLVEKPNLSSKGSELPQPSMHRVFEVGVIRNPGLGAPVFHMTNYFEQPVSNDFSNCMVALGELKLAALCHGEDSITIPYQGSGKGVSFQLVKLGVWKSPTDMQSWVPLSTDDPVIDRLYLSSHRGIIADNQAKWAVPTTRTDDKLRMETCFQQACKGKIQALCENPEWAPLKDNRIPSYGVLSVDLSLAVELKIKIASGFGPLITHGSGMDLYKSNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNR

SEQ ID NO: 35153 - protein, 526 aa, unidentified
  REGION 1..526: note = glycoprotein
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGE

SEQ ID NO: 35154 - protein, 569 aa, unidentified
  REGION 1..569: note = glycoprotein
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 35155 - protein, 524 aa, unidentified
  REGION 1..524: note = glycoprotein
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNT

SEQ ID NO: 35156 - RNA, 19 nt, synthetic construct
  misc_feature 1..19: note = pseudoknot
  source 1..19: mol_type = other RNA
ctttatctcattactttga

SEQ ID NO: 35157 - RNA, 31 nt, synthetic construct
  misc_feature 1..31: note = stem loop
  source 1..31: mol_type = other RNA
aaaacgctttatctcattactttgacgtttt

SEQ ID NO: 35158 - DNA, 20 bp, synthetic construct
  misc_feature 1..20: note = spacer
  source 1..20: mol_type = other DNA
agagcgtgatattaccctgt

SEQ ID NO: 35159 - DNA, 20 bp, synthetic construct
  misc_feature 1..20: note = spacer
  source 1..20: mol_type = other DNA
ccctttgacgttggagtcca

SEQ ID NO: 35160 - DNA, 20 bp, synthetic construct
  misc_feature 1..20: note = spacer
  source 1..20: mol_type = other DNA
tccccgatatgcaccaccgg

SEQ ID NO: 35161 - DNA, 20 bp, synthetic construct
  misc_feature 1..20: note = spacer
  source 1..20: mol_type = other DNA
aagtggctgcgtaccacacc

SEQ ID NO: 35162 - DNA, 20 bp, synthetic construct
  misc_feature 1..20: note = spacer
  source 1..20: mol_type = other DNA
gtacatccacaaacagacga

SEQ ID NO: 35163 - DNA, 20 bp, synthetic construct
  misc_feature 1..20: note = spacer
  source 1..20: mol_type = other DNA
ccgatatgcaccaccgggta

SEQ ID NO: 35164 - DNA, 1896 bp, synthetic construct
  misc_feature 1..1896: note = MA-CA-NC-p1-p6-MS2
  source 1..1896: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 35165 - DNA, 1755 bp, synthetic construct
  misc_feature 1..1755: note = MA-CA-NC-p1-p6-Pro
  source 1..1755: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaa

SEQ ID NO: 35166 - DNA, 2931 bp, synthetic construct
  misc_feature 1..2931: note = CasX 491 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 35167 - DNA, 2937 bp, synthetic construct; identical to SEQ ID NO: 35042
  misc_feature 1..2937: note = CasX 676 variant
  source 1..2937: mol_type = other DNA

SEQ ID NO: 35168 - DNA, 1536 bp, synthetic construct; identical to SEQ ID NO: 1003
  misc_feature 1..1536: note = VSV-G
  source 1..1536: mol_type = other DNA

SEQ ID NO: 35169 - DNA, 96 bp, synthetic construct
  misc_feature 1..96: note = guide scaffold
  source 1..96: mol_type = other DNA
actggcgcttttatctgattactttgagagccatcaccagcgactatgtcgtagtgggtaaagctcacatgaggatcacccatgtgagcatcaaag

SEQ ID NO: 35170 - DNA, 98 bp, synthetic construct
  misc_feature 1..98: note = guide scaffold
  source 1..98: mol_type = other DNA
actggcgcttctatctgattactctgagcgccatcaccagcgactatgtcgtagtgggtaaagccgcacatgaggatcacccatgtgaggcatcagag

SEQ ID NO: 35171 - RNA, 20 nt, synthetic construct
  misc_feature 1..20: note = spacer
  source 1..20: mol_type = other RNA
cagcggggatccgacgagct

SEQ ID NO: 35172 - RNA, 46 nt, synthetic construct
  misc_feature 1..46: note = scaffold
  source 1..46: mol_type = other RNA
actggcgcttttatctgattactttgagagccatcannnatcaaag

SEQ ID NO: 35173 - RNA, 19 nt, synthetic construct
  misc_feature 1..19: note = stem loop
  source 1..19: mol_type = other RNA
acatgaggatcacccatgt
